United States Patent 12,569,549 (FLAVIVIRUS VACCINE) - sequence listing, part 27

SEQ ID NO: 11202 - RNA, 9879 nt, synthetic construct
  misc_feature 1..9879: note = derived and/or modified CDS sequence (opt2) from DENV-1__FJ898402__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggaccgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11203 - RNA, 9879 nt, synthetic construct
  misc_feature 1..9879: note = derived and/or modified CDS sequence (opt2) from DENV-1__FJ898403__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11204 - RNA, 9879 nt, synthetic construct
  misc_feature 1..9879: note = derived and/or modified CDS sequence (opt2) from DENV-1__FJ898404__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11205 - RNA, 9879 nt, synthetic construct
  misc_feature 1..9879: note = derived and/or modified CDS sequence (opt2) from DENV-1__GQ199840__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcaccggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacatcccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11206 - RNA, 9879 nt, synthetic construct
  misc_feature 1..9879: note = derived and/or modified CDS sequence (opt2) from DENV-1__FJ898405__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaacatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11207 - RNA, 9879 nt, synthetic construct
  misc_feature 1..9879: note = derived and/or modified CDS sequence (opt2) from DENV-1__FJ898406__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaacatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatggcctccatgaagcgcttcaagaacgagggcgaccccgagggcgccctctggtga

SEQ ID NO: 11208 - RNA, 9879 nt, synthetic construct
  misc_feature 1..9879: note = derived and/or modified CDS sequence (opt2) from DENV-1__GQ199841__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11209 - RNA, 9879 nt, synthetic construct
  misc_feature 1..9879: note = derived and/or modified CDS sequence (opt2) from DENV-1__FJ898407__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11210 - RNA, 9879 nt, synthetic construct
  misc_feature 1..9879: note = derived and/or modified CDS sequence (opt2) from DENV-1__FJ898408__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgaccccggcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11211 - RNA, 9879 nt, synthetic construct
  misc_feature 1..9879: note = derived and/or modified CDS sequence (opt2) from DENV-1__GQ199843__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11212 - RNA, 9879 nt, synthetic construct
  misc_feature 1..9879: note = derived and/or modified CDS sequence (opt2) from DENV-1__GQ199844__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11213 - RNA, 9879 nt, synthetic construct
  misc_feature 1..9879: note = derived and/or modified CDS sequence (opt2) from DENV-1__GQ199845__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcatgttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccaccaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11214 - RNA, 9879 nt, synthetic construct
  misc_feature 1..9879: note = derived and/or modified CDS sequence (opt2) from DENV-1__GQ199846__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccatcatggcccgcgacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11215 - RNA, 9879 nt, synthetic construct
  misc_feature 1..9879: note = derived and/or modified CDS sequence (opt2) from DENV-1__GQ199847__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgaccccgacgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11216 - RNA, 9879 nt, synthetic construct
  misc_feature 1..9879: note = derived and/or modified CDS sequence (opt2) from DENV-1__GQ199849__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccgcaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcgccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcctcaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagcgcaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcttcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgccctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11217 - RNA, 9879 nt, synthetic construct
  misc_feature 1..9879: note = derived and/or modified CDS sequence (opt2) from DENV-1__FJ898410__SS-prME
  source 1..9879: mol_type = other RNA
tccgtcaccatgctcctcatgctcacccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11218 - RNA, 9879 nt, synthetic construct
  misc_feature 1..9879: note = derived and/or modified CDS sequence (opt2) from DENV-1__FJ898411__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11219 - RNA, 9879 nt, synthetic construct
  misc_feature 1..9879: note = derived and/or modified CDS sequence (opt2) from DENV-1__FJ898412__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgtcaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11220 - RNA, 9879 nt, synthetic construct
  misc_feature 1..9879: note = derived and/or modified CDS sequence (opt2) from DENV-1__GQ199852__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcaccaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctccccctccactgcgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11221 - RNA, 9879 nt, synthetic construct
  misc_feature 1..9879: note = derived and/or modified CDS sequence (opt2) from DENV-1__FJ898415__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaacatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagaccatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11222 - RNA, 9879 nt, synthetic construct
  misc_feature 1..9879: note = derived and/or modified CDS sequence (opt2) from DENV-1__FJ898416__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgtcctctggtga

SEQ ID NO: 11223 - RNA, 9879 nt, synthetic construct
  misc_feature 1..9879: note = derived and/or modified CDS sequence (opt2) from DENV-1__FJ898417__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgaccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11224 - RNA, 9879 nt, synthetic construct
  misc_feature 1..9879: note = derived and/or modified CDS sequence (opt2) from DENV-1__GQ868612__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccctcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11225 - RNA, 9879 nt, synthetic construct
  misc_feature 1..9879: note = derived and/or modified CDS sequence (opt2) from DENV-1__FJ898419__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggctggaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11226 - RNA, 9879 nt, synthetic construct
  misc_feature 1..9879: note = derived and/or modified CDS sequence (opt2) from DENV-1__FJ898420__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggccgcctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccacaagcgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11227 - RNA, 9879 nt, synthetic construct
  misc_feature 1..9879: note = derived and/or modified CDS sequence (opt2) from DENV-1__FJ898421__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctccatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccggccccgagggcgccctctggtga

SEQ ID NO: 11228 - RNA, 9879 nt, synthetic construct
  misc_feature 1..9879: note = derived and/or modified CDS sequence (opt2) from DENV-1__FJ898423__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcatccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagaccaccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatggtccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcacatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11229 - RNA, 9879 nt, synthetic construct
  misc_feature 1..9879: note = derived and/or modified CDS sequence (opt2) from DENV-1__FJ898424__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccaccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11230 - RNA, 9879 nt, synthetic construct
  misc_feature 1..9879: note = derived and/or modified CDS sequence (opt2) from DENV-1__FJ898425__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11231 - RNA, 9879 nt, synthetic construct
  misc_feature 1..9879: note = derived and/or modified CDS sequence (opt2) from DENV-1__FJ898426__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcgccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11232 - RNA, 9879 nt, synthetic construct
  misc_feature 1..9879: note = derived and/or modified CDS sequence (opt2) from DENV-1__GQ199856__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcgtcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacttcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagctcacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11233 - RNA, 9879 nt, synthetic construct
  misc_feature 1..9879: note = derived and/or modified CDS sequence (opt2) from DENV-1__FJ898427__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactgcgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11234 - RNA, 9879 nt, synthetic construct
  misc_feature 1..9879: note = derived and/or modified CDS sequence (opt2) from DENV-1__JF937599__SS-prME
  source 1..9879: mol_type = other RNA
tccgtcaccatgctcctcatgctcatgcccaccgccctcgccttccacctcaccgcccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgaggtccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11235 - RNA, 9879 nt, synthetic construct
  misc_feature 1..9879: note = derived and/or modified CDS sequence (opt2) from DENV-1__FJ898431__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcctcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11236 - RNA, 9879 nt, synthetic construct
  misc_feature 1..9879: note = derived and/or modified CDS sequence (opt2) from DENV-1__GU131678__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcatgaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcaaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttcctcctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgccggcgagcgcaacaaccaggtcctcgaggagaacatggacgtcgagatctggaccaaggagggcgagcgcaagaagctcctcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatgggctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgccaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggccccgccaagctccgctggttcgtcgagcgcaccctcgtcaaccccgagggcaaggtcatcgccctcggctgcggccgcggcgcctggtcctactactgcgccggcctcaagaagggcaccgaggtcaagggctacaccaagggcggccccggccacgaggagcccatccccatggccacctacggctgggacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgaccccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgccccacctgcgtctacaacatgatgggcaagcgcgagaagaagctcggcgagttcggcaaggccaagggctcccgccccatctggtacatgtggctcggcgcccgcttcctcgagttcgaggccctcggcttcatgaacgaggaccactggttctcccgcgagaactccctctccggcgtcgagggcgaggccctccacaagctcggctacatcctccgcgacatctccaagatccccggcggcaacatgtacgccgacgacaccgccggctgggacacccgcatcaccgaggacgacctccagaacgagggcaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggaccctccgcgagaccgcctgcctcggcaagtcctacgcccagatgtggcagctcatgtacttcccccgccgcgccctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccccccgcgccacctggcccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11237 - RNA, 9879 nt, synthetic construct
  misc_feature 1..9879: note = derived and/or modified CDS sequence (opt2) from DENV-1__GU131679__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacatgctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgagctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11238 - RNA, 9879 nt, synthetic construct
  misc_feature 1..9879: note = derived and/or modified CDS sequence (opt2) from DENV-1__GU131680__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11239 - RNA, 9879 nt, synthetic construct
  misc_feature 1..9879: note = derived and/or modified CDS sequence (opt2) from DENV-1__GU131681__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaaggtcctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11240 - RNA, 9879 nt, synthetic construct
  misc_feature 1..9879: note = derived and/or modified CDS sequence (opt2) from DENV-1__GU131682__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11241 - RNA, 9879 nt, synthetic construct
  misc_feature 1..9879: note = derived and/or modified CDS sequence (opt2) from DENV-1__GU131683__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacccccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgcccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgccttcttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11242 - RNA, 9879 nt, synthetic construct
  misc_feature 1..9879: note = derived and/or modified CDS sequence (opt2) from DENV-1__GU131684__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccaaggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11243 - RNA, 9879 nt, synthetic construct
  misc_feature 1..9879: note = derived and/or modified CDS sequence (opt2) from DENV-1__GU131685__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggagaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11244 - RNA, 9879 nt, synthetic construct
  misc_feature 1..9879: note = derived and/or modified CDS sequence (opt2) from DENV-1__GQ868614__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggccccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11245 - RNA, 9879 nt, synthetic construct
  misc_feature 1..9879: note = derived and/or modified CDS sequence (opt2) from DENV-1__GU131688__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11246 - RNA, 9879 nt, synthetic construct
  misc_feature 1..9879: note = derived and/or modified CDS sequence (opt2) from DENV-1__GU131689__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatgaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11247 - RNA, 9879 nt, synthetic construct
  misc_feature 1..9879: note = derived and/or modified CDS sequence (opt2) from DENV-1__GU131690__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11248 - RNA, 9879 nt, synthetic construct
  misc_feature 1..9879: note = derived and/or modified CDS sequence (opt2) from DENV-1__GU131695__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgcacctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11249 - RNA, 9879 nt, synthetic construct
  misc_feature 1..9879: note = derived and/or modified CDS sequence (opt2) from DENV-1__GU131697__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagtaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaacaagcaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11250 - RNA, 9879 nt, synthetic construct
  misc_feature 1..9879: note = derived and/or modified CDS sequence (opt2) from DENV-1__GU131700__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcaccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccatgatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11251 - RNA, 9879 nt, synthetic construct
  misc_feature 1..9879: note = derived and/or modified CDS sequence (opt2) from DENV-1__GU131701__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccaccgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgccttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccaccgcctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccggcaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11252 - RNA, 9879 nt, synthetic construct
  misc_feature 1..9879: note = derived and/or modified CDS sequence (opt2) from DENV-1__GU131703__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11253 - RNA, 9879 nt, synthetic construct
  misc_feature 1..9879: note = derived and/or modified CDS sequence (opt2) from DENV-1__GU131706__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttccgcaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11254 - RNA, 9879 nt, synthetic construct
  misc_feature 1..9879: note = derived and/or modified CDS sequence (opt2) from DENV-1__GU131708__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcacctcctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatgggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11255 - RNA, 9879 nt, synthetic construct
  misc_feature 1..9879: note = derived and/or modified CDS sequence (opt2) from DENV-1__GU131710__SS-prME
  source 1..9879: mol_type = other RNA
tccgtcaccatgctcctcatgctcatgcccaccgccctcgccttccacctcaccacccgcggcggcgagccccacatgatcgcctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagcgcaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11256 - RNA, 9879 nt, synthetic construct
  misc_feature 1..9879: note = derived and/or modified CDS sequence (opt2) from DENV-1__GU131717__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgcaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11257 - RNA, 9879 nt, synthetic construct
  misc_feature 1..9879: note = derived and/or modified CDS sequence (opt2) from DENV-1__GU131718__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccatcgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcatcgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11258 - RNA, 9879 nt, synthetic construct
  misc_feature 1..9879: note = derived and/or modified CDS sequence (opt2) from DENV-1__GU131720__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcgccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatgaagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11259 - RNA, 9879 nt, synthetic construct
  misc_feature 1..9879: note = derived and/or modified CDS sequence (opt2) from DENV-1__HM181960__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggccgcgtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11260 - RNA, 9879 nt, synthetic construct
  misc_feature 1..9879: note = derived and/or modified CDS sequence (opt2) from DENV-1__HM181963__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagatcggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaaggtcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11261 - RNA, 9879 nt, synthetic construct
  misc_feature 1..9879: note = derived and/or modified CDS sequence (opt2) from DENV-1__HM181964__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttccccctctccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11262 - RNA, 9879 nt, synthetic construct
  misc_feature 1..9879: note = derived and/or modified CDS sequence (opt2) from DENV-1__HM181966__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccaccctcgacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatcgccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcgtcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11263 - RNA, 9879 nt, synthetic construct
  misc_feature 1..9879: note = derived and/or modified CDS sequence (opt2) from DENV-1__GU131721__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcgtccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgagcccgagggcgccctctggtga

SEQ ID NO: 11264 - RNA, 9879 nt, synthetic construct
  misc_feature 1..9879: note = derived and/or modified CDS sequence (opt2) from DENV-1__GU131723__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11265 - RNA, 9879 nt, synthetic construct
  misc_feature 1..9879: note = derived and/or modified CDS sequence (opt2) from DENV-1__GU131725__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttctccgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagggcgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctcccgcggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11266 - RNA, 9879 nt, synthetic construct
  misc_feature 1..9879: note = derived and/or modified CDS sequence (opt2) from DENV-1__GU131726__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcgccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcctccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctcccccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11267 - RNA, 9879 nt, synthetic construct
  misc_feature 1..9879: note = derived and/or modified CDS sequence (opt2) from DENV-1__GU131727__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgtacctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11268 - RNA, 9879 nt, synthetic construct
  misc_feature 1..9879: note = derived and/or modified CDS sequence (opt2) from DENV-1__HM631850__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctcccccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11269 - RNA, 9879 nt, synthetic construct
  misc_feature 1..9879: note = derived and/or modified CDS sequence (opt2) from DENV-1__KF955446__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggccgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcggcgcctccgagatggccgaggccctcaagggcatgcccatccgctaccagaccaccgccgtcaagtccgagcacaccggcaaggagatcgtcgacctcatgggccacgccaccttcaccatgggcctcctcgcccccggccgcgtccccaactacaacatggtcatcatggacgaggcccacttcaccgacccctcccgcatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaaccccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgccccctggaccgaggccaagatgctcctcgacaacatcaacacccccgagggcatcatccccgccctcttcgagcccgagcgcgagaagtccgccgccatcgacggcgagtcccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaccaaccaggtcctcgaggagaacatggccgtcgagatctggcccaaggagggcgagcgcaagaagctccgcccccgctgcctcgacgcccgcacctactccgaccccctcgccctccgcgagttcaaggagttcccccccggccgccgctccgtctccggcgacctcatcctcgagatcggcaagctcccccaccccctcacccagcgcccccagaacgccctcgccaccctcgtcatgtcccacacctccgagcagggcggccgcgcctaccgccacgccatggaggagctccccgccaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgactccaacgccacccgccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgccaagggctggcccatctccaagatggacatcggcgtccccctcctcgccctcggctgctactcccaggtcaaccccctcaccctcaccgcccccgtcctcatgctcgtcccccactaccccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctcaccaagtccgagttcaacacctacaagcgctccggcatcatggaggtcgaccgctccgaggccaaggagggcctcaagcgcggcgagaccaccaagcaccccgtctcccgcggcaccgccaagctccgctggttcgtcgagcgcaccctcgtcaagcccgagggcaaggtcatcgacctcggctgcggccgcggcggctggtcctactactgcgccggcctcaagaaggtcaccgaggtcaagggctacaccaagggcggccccggccacgaggaccccatccccatgggcacctacggctggaacctcgtcaagctccgctccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatggcctccgtcgtcgagaccctcgagcagatgcagcgcaagcacggcggcatgctcgtccgcaaccccctctcccgcaactccacccacgagatgtactgggtctcctggggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgagggcaagccctccggctccgcctcctccatggtcaacggcggcgtcaagctcctcaccaagccctgggacggcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccggcggcatcttctccccccgcgagctcgagacccccaacctcgccgagcgcgtcctcgactgggtcgagaagtacggcgtcgagcgcctcgagcgcatggccatctccggcgacgactgcctcggcgagcccatctacgaccgcttcgccaccgccctcaccgccctcaacgacatgggcaaggtccgcaaggacatcccccagtgggagccctccaagggctggaacgactggcagcagggccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatggacttccaccgccgcgacctccgcctcgccgccaacgccatctggtccgccggccccggcgactggatccccacccgccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatggcctccatgaagcgcttcaagaacgagtccgaccccgagggcgccctctggtga

SEQ ID NO: 11270 - RNA, 9879 nt, synthetic construct
  misc_feature 1..9879: note = derived and/or modified CDS sequence (opt2) from DENV-1__KF921942__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcgccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11271 - RNA, 9879 nt, synthetic construct
  misc_feature 1..9879: note = derived and/or modified CDS sequence (opt2) from DENV-1__JF937602__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11272 - RNA, 9879 nt, synthetic construct
  misc_feature 1..9879: note = derived and/or modified CDS sequence (opt2) from DENV-1__GU131729__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctcggcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggccccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgcccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaccctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgagggcaagccctccggctccgcctcctccatgggcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11273 - RNA, 9879 nt, synthetic construct
  misc_feature 1..9879: note = derived and/or modified CDS sequence (opt2) from DENV-1__GU131730__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccgcgccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccaccatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacatctacatgggccagcccctcaacaacgacgaggaccacgccccctggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11274 - RNA, 9879 nt, synthetic construct
  misc_feature 1..9879: note = derived and/or modified CDS sequence (opt2) from DENV-1__GU131731__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcacccacaacaaggagggcgaccagtacatctccatgggccagcccctcaacaccgccgaggaccacgccccctggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggaccccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11275 - RNA, 9879 nt, synthetic construct
  misc_feature 1..9879: note = derived and/or modified CDS sequence (opt2) from DENV-1__GU131733__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacatcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11276 - RNA, 9879 nt, synthetic construct
  misc_feature 1..9879: note = derived and/or modified CDS sequence (opt2) from DENV-1__GU131734__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccgactccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcatcgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11277 - RNA, 9879 nt, synthetic construct
  misc_feature 1..9879: note = derived and/or modified CDS sequence (opt2) from DENV-1__GU131738__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccggccgctcctggaactccggctacgagtggatcaccgacttccccggcaagaccgtctggttcggccccaccatcaagtccggcaacgacatcgccaactgcctccgcaagaacggcaagcgcgtcatccagctctcccgcaagaccttcgacaccgagtaccagaagaccaagaacaacgactgggactacgtcggcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcggccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11278 - RNA, 9879 nt, synthetic construct
  misc_feature 1..9879: note = derived and/or modified CDS sequence (opt2) from DENV-1__JF937604__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagaccttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggcttctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctacgccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcagggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctcccagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11279 - RNA, 9879 nt, synthetic construct
  misc_feature 1..9879: note = derived and/or modified CDS sequence (opt2) from DENV-1__JF937605__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccctccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggccaacgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11280 - RNA, 9879 nt, synthetic construct
  misc_feature 1..9879: note = derived and/or modified CDS sequence (opt2) from DENV-1__JF937608__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11281 - RNA, 9879 nt, synthetic construct
  misc_feature 1..9879: note = derived and/or modified CDS sequence (opt2) from DENV-1__GU131739__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacacccccaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11282 - RNA, 9879 nt, synthetic construct
  misc_feature 1..9879: note = derived and/or modified CDS sequence (opt2) from DENV-1__GU131740__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgtcccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaaggtctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11283 - RNA, 9879 nt, synthetic construct
  misc_feature 1..9879: note = derived and/or modified CDS sequence (opt2) from DENV-1__GU131741__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgtctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11284 - RNA, 9879 nt, synthetic construct
  misc_feature 1..9879: note = derived and/or modified CDS sequence (opt2) from DENV-1__GU131743__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacgtcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11285 - RNA, 9879 nt, synthetic construct
  misc_feature 1..9879: note = derived and/or modified CDS sequence (opt2) from DENV-1__JN093516__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccacccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11286 - RNA, 9879 nt, synthetic construct
  misc_feature 1..9879: note = derived and/or modified CDS sequence (opt2) from DENV-1__GU131746__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11287 - RNA, 9879 nt, synthetic construct
  misc_feature 1..9879: note = derived and/or modified CDS sequence (opt2) from DENV-1__JF937609__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11288 - RNA, 9879 nt, synthetic construct
  misc_feature 1..9879: note = derived and/or modified CDS sequence (opt2) from DENV-1__KF921949__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttccgcaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcaccaagaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11289 - RNA, 9879 nt, synthetic construct
  misc_feature 1..9879: note = derived and/or modified CDS sequence (opt2) from DENV-1__GU131747__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcttcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccgtcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11290 - RNA, 9879 nt, synthetic construct
  misc_feature 1..9879: note = derived and/or modified CDS sequence (opt2) from DENV-1__GU131748__SS-prME
  source 1..9879: mol_type = other RNA
tccgtcaccatgctcttcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcaagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11291 - RNA, 9879 nt, synthetic construct
  misc_feature 1..9879: note = derived and/or modified CDS sequence (opt2) from DENV-1__GQ868615__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11292 - RNA, 9879 nt, synthetic construct
  misc_feature 1..9879: note = derived and/or modified CDS sequence (opt2) from DENV-1__GU131749__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctaccgcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11293 - RNA, 9879 nt, synthetic construct
  misc_feature 1..9879: note = derived and/or modified CDS sequence (opt2) from DENV-1__GU131750__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccatcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcatgcagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacaccatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11294 - RNA, 9879 nt, synthetic construct
  misc_feature 1..9879: note = derived and/or modified CDS sequence (opt2) from DENV-1__GU131751__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaaggtcatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatccgcgactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctccaagtggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacatcccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccaccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11295 - RNA, 9879 nt, synthetic construct
  misc_feature 1..9879: note = derived and/or modified CDS sequence (opt2) from DENV-1__GU131753__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcatcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatgaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcaccgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcttcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11296 - RNA, 9879 nt, synthetic construct
  misc_feature 1..9879: note = derived and/or modified CDS sequence (opt2) from DENV-1__GU131754__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggacaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcatgtccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11297 - RNA, 9879 nt, synthetic construct
  misc_feature 1..9879: note = derived and/or modified CDS sequence (opt2) from DENV-1__GU131755__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11298 - RNA, 9879 nt, synthetic construct
  misc_feature 1..9879: note = derived and/or modified CDS sequence (opt2) from DENV-1__GU131756__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgccttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11299 - RNA, 9879 nt, synthetic construct
  misc_feature 1..9879: note = derived and/or modified CDS sequence (opt2) from DENV-1__GU131758__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgtcccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaaggtctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11300 - RNA, 9879 nt, synthetic construct
  misc_feature 1..9879: note = derived and/or modified CDS sequence (opt2) from DENV-1__GU131759__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaaggtctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11301 - RNA, 9879 nt, synthetic construct
  misc_feature 1..9879: note = derived and/or modified CDS sequence (opt2) from DENV-1__GU131761__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatccaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11302 - RNA, 9879 nt, synthetic construct
  misc_feature 1..9879: note = derived and/or modified CDS sequence (opt2) from DENV-1__GU131762__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccatgtccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcctctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcgtctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11303 - RNA, 9879 nt, synthetic construct
  misc_feature 1..9879: note = derived and/or modified CDS sequence (opt2) from DENV-1__GU131763__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggcctcggcgaggtcgactccttctccctcggcctcctctgcatctccatcatgatcgaggaggtcatgcgctcccgctggtcccgcaagatgctcatggccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagcgctgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaacaaggtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11304 - RNA, 9879 nt, synthetic construct
  misc_feature 1..9879: note = derived and/or modified CDS sequence (opt2) from DENV-1__GU131766__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccatcgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcatcgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgcgccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11305 - RNA, 9879 nt, synthetic construct
  misc_feature 1..9879: note = derived and/or modified CDS sequence (opt2) from DENV-1__GU131767__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccgcgccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11306 - RNA, 9879 nt, synthetic construct
  misc_feature 1..9879: note = derived and/or modified CDS sequence (opt2) from DENV-1__HM181967__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacatggccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11307 - RNA, 9879 nt, synthetic construct
  misc_feature 1..9879: note = derived and/or modified CDS sequence (opt2) from DENV-1__GU131768__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcaactggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgccgacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11308 - RNA, 9879 nt, synthetic construct
  misc_feature 1..9879: note = derived and/or modified CDS sequence (opt2) from DENV-1__GU131770__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11309 - RNA, 9879 nt, synthetic construct
  misc_feature 1..9879: note = derived and/or modified CDS sequence (opt2) from DENV-1__GU131773__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcatgaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttcctcctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11310 - RNA, 9879 nt, synthetic construct
  misc_feature 1..9879: note = derived and/or modified CDS sequence (opt2) from DENV-1__GU131775__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcgtcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcggcaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11311 - RNA, 9879 nt, synthetic construct
  misc_feature 1..9879: note = derived and/or modified CDS sequence (opt2) from DENV-1__GU131777__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11312 - RNA, 9879 nt, synthetic construct
  misc_feature 1..9879: note = derived and/or modified CDS sequence (opt2) from DENV-1__GU131778__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacatcccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctcccgcatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11313 - RNA, 9879 nt, synthetic construct
  misc_feature 1..9879: note = derived and/or modified CDS sequence (opt2) from DENV-1__GU131779__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgtctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11314 - RNA, 9879 nt, synthetic construct
  misc_feature 1..9879: note = derived and/or modified CDS sequence (opt2) from DENV-1__GU131780__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttctccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcaccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccatgatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11315 - RNA, 9879 nt, synthetic construct
  misc_feature 1..9879: note = derived and/or modified CDS sequence (opt2) from DENV-1__GU131781__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggacaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcatgtccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11316 - RNA, 9879 nt, synthetic construct
  misc_feature 1..9879: note = derived and/or modified CDS sequence (opt2) from DENV-1__GU131782__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggcctcggcgaggtcgactccttctccctcggcctcctctgcatctccatcatgatcgaggaggtcatgcgctcccgctggtcccgcaagatgctcatggccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagcgctgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11317 - RNA, 9879 nt, synthetic construct
  misc_feature 1..9879: note = derived and/or modified CDS sequence (opt2) from DENV-1__GU131784__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccaccacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11318 - RNA, 9879 nt, synthetic construct
  misc_feature 1..9879: note = derived and/or modified CDS sequence (opt2) from DENV-1__JF937612__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatccgcgactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11319 - RNA, 9879 nt, synthetic construct
  misc_feature 1..9879: note = derived and/or modified CDS sequence (opt2) from DENV-1__GU131786__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggcccccgcccgcggcgcccgccgcatggccatcctcggcgccaccgcctgggacttcggctccatcggcggcgtcttcccctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccgcgccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11320 - RNA, 9879 nt, synthetic construct
  misc_feature 1..9879: note = derived and/or modified CDS sequence (opt2) from DENV-1__GU131787__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11321 - RNA, 9879 nt, synthetic construct
  misc_feature 1..9879: note = derived and/or modified CDS sequence (opt2) from DENV-1__HM181968__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcgccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcctccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11322 - RNA, 9879 nt, synthetic construct
  misc_feature 1..9879: note = derived and/or modified CDS sequence (opt2) from DENV-1__GU131789__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccatcctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11323 - RNA, 9879 nt, synthetic construct
  misc_feature 1..9879: note = derived and/or modified CDS sequence (opt2) from DENV-1__GU131790__SS-prME
  source 1..9879: mol_type = other RNA
tccgtcaccatgctcctcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagctcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcaagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11324 - RNA, 9879 nt, synthetic construct
  misc_feature 1..9879: note = derived and/or modified CDS sequence (opt2) from DENV-1__GU131791__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggccccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatcctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11325 - RNA, 9879 nt, synthetic construct
  misc_feature 1..9879: note = derived and/or modified CDS sequence (opt2) from DENV-1__GU131792__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagccctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgccttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaccttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctccccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccggcctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcggcaccaacgaggtccacacctggaccgagcagtacaagttccaggccgactcccccaagcgcctctccgccgccatcggcaagccctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatggccgccgccatcaaggaccgcaaggccgtccacgccgacatgggctactggatcgagtccgagaagaacgagccctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcgcccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11326 - RNA, 9879 nt, synthetic construct
  misc_feature 1..9879: note = derived and/or modified CDS sequence (opt2) from DENV-1__HM488256__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctccccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgcccccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctgggccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatctcccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcccctggaacgacctcatccgcctctgcatcatggtcggcgccaccgcctccgcccgcatgggcatgggcaccacctccctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgggcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11327 - RNA, 9879 nt, synthetic construct
  misc_feature 1..9879: note = derived and/or modified CDS sequence (opt2) from DENV-1__GU131793__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccaccacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11328 - RNA, 9879 nt, synthetic construct
  misc_feature 1..9879: note = derived and/or modified CDS sequence (opt2) from DENV-1__GU131794__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11329 - RNA, 9879 nt, synthetic construct
  misc_feature 1..9879: note = derived and/or modified CDS sequence (opt2) from DENV-1__GU131796__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcgtcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctcctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11330 - RNA, 9879 nt, synthetic construct
  misc_feature 1..9879: note = derived and/or modified CDS sequence (opt2) from DENV-1__GU131797__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11331 - RNA, 9879 nt, synthetic construct
  misc_feature 1..9879: note = derived and/or modified CDS sequence (opt2) from DENV-1__GU131801__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcggcatcggcgccggcgagaaggccctcaagctctcctgggtcaagaagggctcctccatcggcaagatggtcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11332 - RNA, 9879 nt, synthetic construct
  misc_feature 1..9879: note = derived and/or modified CDS sequence (opt2) from DENV-1__GU131804__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacatcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11333 - RNA, 9879 nt, synthetic construct
  misc_feature 1..9879: note = derived and/or modified CDS sequence (opt2) from DENV-1__GU131805__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctcccccgagatccagctccccgactacggcgccctcaccctcgactgctccccccgccccggcctcgacttcaacgagatggtcctcctccccatgaaggagaagtcctggctcgtccacaagcagtggttcctcgacctccccctcccctggacctccggcgcctccacctcccaggagacctggaaccgcaaggacctcctcggcaccttcaagaccgcccacgccaaggagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagcccgccttcggcgagtcctacatcgtcatcggcgccggcgagaaggccctcaagctctcctgggtcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcggcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgccatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagccctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtccccggcaagatcatccacgagtggtgctgccgctcctgcaccctcccccccctccgcttcaagggcgaggacggctgctggtacggcatggagatctcccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggccccctccccgtcttcttcctcctcatcatgggccagctcccctggaacgacctcatccgcctctgcatcatggtcggcgccaacgcctccgaccgcatgggcatgggcaccccctacctcgccctcatggccaccttcaagatgcgccccatgttcgccgtcggcctcctcttccgccgcctcacctcccgcgagggcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctcgccctcaccttcatcaagaccaccttctccctcgactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcggctcccacaacatcctcgtcgaggtccaggacgacggcaccatgaagatcaaggacgaggagcgcgacgccaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11334 - RNA, 9879 nt, synthetic construct
  misc_feature 1..9879: note = derived and/or modified CDS sequence (opt2) from DENV-1__GU131806__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcgcctggacctccggcggctccacctcccaggagacctggaaccgccaggacctcgtcgtcaccttcaagaccgcccacggcaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcgccaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcccctcccacaacatcctcgtcgaggtccaggacgacggccccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcctcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11335 - RNA, 9879 nt, synthetic construct
  misc_feature 1..9879: note = derived and/or modified CDS sequence (opt2) from DENV-1__GU131807__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagcccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcgtcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggccccgcctacggcgtcctcttctccggcgtctcctggcccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgaccactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagaagaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11336 - RNA, 9879 nt, synthetic construct
  misc_feature 1..9879: note = derived and/or modified CDS sequence (opt2) from DENV-1__GU131811__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagatcggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgagaccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaaggtcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11337 - RNA, 9882 nt, synthetic construct
  misc_feature 1..9882: note = derived and/or modified CDS sequence (opt2) from DENV-1__JF937615__SS-prME
  source 1..9882: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccgaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccgactccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcatcgacttccagtcccaccagctctgggccaccctcctctccctcaccttcatcaagaccaccttctccctccactacgcctggaagaccatggccatggtcctctccatcgtctccctcttccccctcctccccgtccacgacctccccaagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgttcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11338 - RNA, 9879 nt, synthetic construct
  misc_feature 1..9879: note = derived and/or modified CDS sequence (opt2) from DENV-1__GU131814__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacgagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11339 - RNA, 9879 nt, synthetic construct
  misc_feature 1..9879: note = derived and/or modified CDS sequence (opt2) from DENV-1__GU131815__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcacccgcctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcaccatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgcctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccgtcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11340 - RNA, 9879 nt, synthetic construct
  misc_feature 1..9879: note = derived and/or modified CDS sequence (opt2) from DENV-1__GU131818__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcgtcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgcctccctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctcaaggagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11341 - RNA, 9879 nt, synthetic construct
  misc_feature 1..9879: note = derived and/or modified CDS sequence (opt2) from DENV-1__GU131820__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggcctcggcgaggtcgactccttctccctcggcctcctctgcatctccatcatgatcgaggaggtcatgcgctcccgctggtcccgcaagatgctcatggccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagcgctgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11342 - RNA, 9879 nt, synthetic construct
  misc_feature 1..9879: note = derived and/or modified CDS sequence (opt2) from DENV-1__HM181970__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggaggacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11343 - RNA, 9879 nt, synthetic construct
  misc_feature 1..9879: note = derived and/or modified CDS sequence (opt2) from DENV-1__GU131821__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11344 - RNA, 9879 nt, synthetic construct
  misc_feature 1..9879: note = derived and/or modified CDS sequence (opt2) from DENV-1__JF937617__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatgggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgagatcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11345 - RNA, 9879 nt, synthetic construct
  misc_feature 1..9879: note = derived and/or modified CDS sequence (opt2) from DENV-1__JF937618__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaacccccgcaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggaccgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11346 - RNA, 9879 nt, synthetic construct
  misc_feature 1..9879: note = derived and/or modified CDS sequence (opt2) from DENV-1__JF937619__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggtcaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaagaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcatctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11347 - RNA, 9879 nt, synthetic construct
  misc_feature 1..9879: note = derived and/or modified CDS sequence (opt2) from DENV-1__GU131827__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttccgcaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgccatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcgtccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11348 - RNA, 9879 nt, synthetic construct
  misc_feature 1..9879: note = derived and/or modified CDS sequence (opt2) from DENV-1__GU131831__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11349 - RNA, 9879 nt, synthetic construct
  misc_feature 1..9879: note = derived and/or modified CDS sequence (opt2) from DENV-1__EU482789__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagatggagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggccgcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11350 - RNA, 9879 nt, synthetic construct
  misc_feature 1..9879: note = derived and/or modified CDS sequence (opt2) from DENV-1__EU482790__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggctcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgtcccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtccccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11351 - RNA, 9879 nt, synthetic construct
  misc_feature 1..9879: note = derived and/or modified CDS sequence (opt2) from DENV-1__EU482791__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11352 - RNA, 9879 nt, synthetic construct
  misc_feature 1..9879: note = derived and/or modified CDS sequence (opt2) from DENV-1__EU482792__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11353 - RNA, 9879 nt, synthetic construct
  misc_feature 1..9879: note = derived and/or modified CDS sequence (opt2) from DENV-1__EU482707__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11354 - RNA, 9879 nt, synthetic construct
  misc_feature 1..9879: note = derived and/or modified CDS sequence (opt2) from DENV-1__EU482708__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatctccgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11355 - RNA, 9879 nt, synthetic construct
  misc_feature 1..9879: note = derived and/or modified CDS sequence (opt2) from DENV-1__EU482709__SS-prME
  source 1..9879: mol_type = other RNA
tccgtcaccatgctcctcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11356 - RNA, 9879 nt, synthetic construct
  misc_feature 1..9879: note = derived and/or modified CDS sequence (opt2) from DENV-1__EU482710__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagcactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatctccgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcatcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11357 - RNA, 9879 nt, synthetic construct
  misc_feature 1..9879: note = derived and/or modified CDS sequence (opt2) from DENV-1__EU482712__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagaactacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcctcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11358 - RNA, 9879 nt, synthetic construct
  misc_feature 1..9879: note = derived and/or modified CDS sequence (opt2) from DENV-1__EU249490__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgccgcaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11359 - RNA, 9879 nt, synthetic construct
  misc_feature 1..9879: note = derived and/or modified CDS sequence (opt2) from DENV-1__EU249491__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11360 - RNA, 9879 nt, synthetic construct
  misc_feature 1..9879: note = derived and/or modified CDS sequence (opt2) from DENV-1__EU249492__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtccagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggctcccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgacacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccggccccgagggcgccctctggtga

SEQ ID NO: 11361 - RNA, 9879 nt, synthetic construct
  misc_feature 1..9879: note = derived and/or modified CDS sequence (opt2) from DENV-1__EU249493__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgacaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11362 - RNA, 9879 nt, synthetic construct
  misc_feature 1..9879: note = derived and/or modified CDS sequence (opt2) from DENV-1__EU249494__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactgcatgacctccatgaagcgcttcaagaacgagggcgaccccgagggcgccctctggtga

SEQ ID NO: 11363 - RNA, 9879 nt, synthetic construct
  misc_feature 1..9879: note = derived and/or modified CDS sequence (opt2) from DENV-1__EU249495__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagaccaccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11364 - RNA, 9879 nt, synthetic construct
  misc_feature 1..9879: note = derived and/or modified CDS sequence (opt2) from DENV-1__EU482794__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaactacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11365 - RNA, 9879 nt, synthetic construct
  misc_feature 1..9879: note = derived and/or modified CDS sequence (opt2) from DENV-1__EU482795__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttctccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgccgcaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11366 - RNA, 9879 nt, synthetic construct
  misc_feature 1..9879: note = derived and/or modified CDS sequence (opt2) from DENV-1__EU482796__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11367 - RNA, 9879 nt, synthetic construct
  misc_feature 1..9879: note = derived and/or modified CDS sequence (opt2) from DENV-1__EU482797__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11368 - RNA, 9879 nt, synthetic construct
  misc_feature 1..9879: note = derived and/or modified CDS sequence (opt2) from DENV-1__EU482799__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgagatccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11369 - RNA, 9879 nt, synthetic construct
  misc_feature 1..9879: note = derived and/or modified CDS sequence (opt2) from DENV-1__EU482800__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggccagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccatcgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcttcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11370 - RNA, 9879 nt, synthetic construct
  misc_feature 1..9879: note = derived and/or modified CDS sequence (opt2) from DENV-1__EU482801__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11371 - RNA, 9879 nt, synthetic construct
  misc_feature 1..9879: note = derived and/or modified CDS sequence (opt2) from DENV-1__EU482802__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgccgcaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaagtccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11372 - RNA, 9879 nt, synthetic construct
  misc_feature 1..9879: note = derived and/or modified CDS sequence (opt2) from DENV-1__EU482804__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaaggtcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcaccggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11373 - RNA, 9879 nt, synthetic construct
  misc_feature 1..9879: note = derived and/or modified CDS sequence (opt2) from DENV-1__EU482806__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctgcgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11374 - RNA, 9879 nt, synthetic construct
  misc_feature 1..9879: note = derived and/or modified CDS sequence (opt2) from DENV-1__EU482807__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcgtcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11375 - RNA, 9879 nt, synthetic construct
  misc_feature 1..9879: note = derived and/or modified CDS sequence (opt2) from DENV-1__EU482808__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcgacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11376 - RNA, 9879 nt, synthetic construct
  misc_feature 1..9879: note = derived and/or modified CDS sequence (opt2) from DENV-1__EU482809__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11377 - RNA, 9879 nt, synthetic construct
  misc_feature 1..9879: note = derived and/or modified CDS sequence (opt2) from DENV-1__EU482810__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtccagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggctcccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgacacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccggccccgagggcgccctctggtga

SEQ ID NO: 11378 - RNA, 9879 nt, synthetic construct
  misc_feature 1..9879: note = derived and/or modified CDS sequence (opt2) from DENV-1__EU482811__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11379 - RNA, 9879 nt, synthetic construct
  misc_feature 1..9879: note = derived and/or modified CDS sequence (opt2) from DENV-1__EU482812__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11380 - RNA, 9879 nt, synthetic construct
  misc_feature 1..9879: note = derived and/or modified CDS sequence (opt2) from DENV-1__EU482813__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgaggaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11381 - RNA, 9879 nt, synthetic construct
  misc_feature 1..9879: note = derived and/or modified CDS sequence (opt2) from DENV-1__EU482814__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcttcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11382 - RNA, 9879 nt, synthetic construct
  misc_feature 1..9879: note = derived and/or modified CDS sequence (opt2) from DENV-1__EU482815__SS-prME
  source 1..9879: mol_type = other RNA
tccgtcaccatgctcctcatgctcatgcccgccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcaccgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcttcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11383 - RNA, 9879 nt, synthetic construct
  misc_feature 1..9879: note = derived and/or modified CDS sequence (opt2) from DENV-1__EU482816__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11384 - RNA, 9879 nt, synthetic construct
  misc_feature 1..9879: note = derived and/or modified CDS sequence (opt2) from DENV-1__EU482821__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11385 - RNA, 9879 nt, synthetic construct
  misc_feature 1..9879: note = derived and/or modified CDS sequence (opt2) from DENV-1__EU482822__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccactccatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11386 - RNA, 9879 nt, synthetic construct
  misc_feature 1..9879: note = derived and/or modified CDS sequence (opt2) from DENV-1__EU482476__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcgccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11387 - RNA, 9879 nt, synthetic construct
  misc_feature 1..9879: note = derived and/or modified CDS sequence (opt2) from DENV-1__EU482477__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11388 - RNA, 9879 nt, synthetic construct
  misc_feature 1..9879: note = derived and/or modified CDS sequence (opt2) from DENV-1__EU482478__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11389 - RNA, 9879 nt, synthetic construct
  misc_feature 1..9879: note = derived and/or modified CDS sequence (opt2) from DENV-1__EU482479__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatctgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcgtcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11390 - RNA, 9879 nt, synthetic construct
  misc_feature 1..9879: note = derived and/or modified CDS sequence (opt2) from DENV-1__EU482480__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgcacccagatcggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgccaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11391 - RNA, 9879 nt, synthetic construct
  misc_feature 1..9879: note = derived and/or modified CDS sequence (opt2) from DENV-1__EU482481__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatctccgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcatcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11392 - RNA, 9879 nt, synthetic construct
  misc_feature 1..9879: note = derived and/or modified CDS sequence (opt2) from DENV-1__EU482482__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11393 - RNA, 9879 nt, synthetic construct
  misc_feature 1..9879: note = derived and/or modified CDS sequence (opt2) from DENV-1__EU482485__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccaccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccgtcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11394 - RNA, 9879 nt, synthetic construct
  misc_feature 1..9879: note = derived and/or modified CDS sequence (opt2) from DENV-1__EU482486__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgactccgaccccgagggcgccctctggtga

SEQ ID NO: 11395 - RNA, 9879 nt, synthetic construct
  misc_feature 1..9879: note = derived and/or modified CDS sequence (opt2) from DENV-1__EU482487__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgccaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11396 - RNA, 9879 nt, synthetic construct
  misc_feature 1..9879: note = derived and/or modified CDS sequence (opt2) from DENV-1__EU482488__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11397 - RNA, 9879 nt, synthetic construct
  misc_feature 1..9879: note = derived and/or modified CDS sequence (opt2) from DENV-1__EU482489__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccctcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11398 - RNA, 9879 nt, synthetic construct
  misc_feature 1..9879: note = derived and/or modified CDS sequence (opt2) from DENV-1__EU482490__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcaccatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11399 - RNA, 9879 nt, synthetic construct
  misc_feature 1..9879: note = derived and/or modified CDS sequence (opt2) from DENV-1__EU482491__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgcacccagatcggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgccaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11400 - RNA, 9879 nt, synthetic construct
  misc_feature 1..9879: note = derived and/or modified CDS sequence (opt2) from DENV-1__EU482493__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11401 - RNA, 9879 nt, synthetic construct
  misc_feature 1..9879: note = derived and/or modified CDS sequence (opt2) from DENV-1__EU482494__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatcacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgccaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11402 - RNA, 9879 nt, synthetic construct
  misc_feature 1..9879: note = derived and/or modified CDS sequence (opt2) from DENV-1__EU482495__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgactccgaccccgagggcgccctctggtga

SEQ ID NO: 11403 - RNA, 9879 nt, synthetic construct
  misc_feature 1..9879: note = derived and/or modified CDS sequence (opt2) from DENV-1__EU482496__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11404 - RNA, 9879 nt, synthetic construct
  misc_feature 1..9879: note = derived and/or modified CDS sequence (opt2) from DENV-1__EU482497__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccagggcacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacaccatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11405 - RNA, 9879 nt, synthetic construct
  misc_feature 1..9879: note = derived and/or modified CDS sequence (opt2) from DENV-1__EU482499__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11406 - RNA, 9879 nt, synthetic construct
  misc_feature 1..9879: note = derived and/or modified CDS sequence (opt2) from DENV-1__EU482500__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggaggccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11407 - RNA, 9879 nt, synthetic construct
  misc_feature 1..9879: note = derived and/or modified CDS sequence (opt2) from DENV-1__EU482501__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11408 - RNA, 9879 nt, synthetic construct
  misc_feature 1..9879: note = derived and/or modified CDS sequence (opt2) from DENV-1__EU482504__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggtcaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatctccgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11409 - RNA, 9879 nt, synthetic construct
  misc_feature 1..9879: note = derived and/or modified CDS sequence (opt2) from DENV-1__EU482505__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttcaaccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11410 - RNA, 9879 nt, synthetic construct
  misc_feature 1..9879: note = derived and/or modified CDS sequence (opt2) from DENV-1__EU482506__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11411 - RNA, 9879 nt, synthetic construct
  misc_feature 1..9879: note = derived and/or modified CDS sequence (opt2) from DENV-1__EU482509__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcgtccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgagcccgagggcgccctctggtga

SEQ ID NO: 11412 - RNA, 9879 nt, synthetic construct
  misc_feature 1..9879: note = derived and/or modified CDS sequence (opt2) from DENV-1__EU482510__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctccgcaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11413 - RNA, 9879 nt, synthetic construct
  misc_feature 1..9879: note = derived and/or modified CDS sequence (opt2) from DENV-1__EU482511__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatgtcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11414 - RNA, 9879 nt, synthetic construct
  misc_feature 1..9879: note = derived and/or modified CDS sequence (opt2) from DENV-1__EU482513__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11415 - RNA, 9879 nt, synthetic construct
  misc_feature 1..9879: note = derived and/or modified CDS sequence (opt2) from DENV-1__EU482515__SS-prME
  source 1..9879: mol_type = other RNA
tccgtcaccaccctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatgtcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccaagaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11416 - RNA, 9879 nt, synthetic construct
  misc_feature 1..9879: note = derived and/or modified CDS sequence (opt2) from DENV-1__EU482516__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11417 - RNA, 9879 nt, synthetic construct
  misc_feature 1..9879: note = derived and/or modified CDS sequence (opt2) from DENV-1__EU482517__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaacaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggactccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11418 - RNA, 9879 nt, synthetic construct
  misc_feature 1..9879: note = derived and/or modified CDS sequence (opt2) from DENV-1__EU482519__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaaggtcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11419 - RNA, 9879 nt, synthetic construct
  misc_feature 1..9879: note = derived and/or modified CDS sequence (opt2) from DENV-1__EU482520__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgcgcgagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacggccactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcatcctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11420 - RNA, 9879 nt, synthetic construct
  misc_feature 1..9879: note = derived and/or modified CDS sequence (opt2) from DENV-1__EU482521__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggccgcatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggcgctcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacatctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagatcaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11421 - RNA, 9879 nt, synthetic construct
  misc_feature 1..9879: note = derived and/or modified CDS sequence (opt2) from DENV-1__EU482523__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11422 - RNA, 9879 nt, synthetic construct
  misc_feature 1..9879: note = derived and/or modified CDS sequence (opt2) from DENV-1__EU482525__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagaccgaccccgagggcgccctctggtga

SEQ ID NO: 11423 - RNA, 9879 nt, synthetic construct
  misc_feature 1..9879: note = derived and/or modified CDS sequence (opt2) from DENV-1__EU482526__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11424 - RNA, 9879 nt, synthetic construct
  misc_feature 1..9879: note = derived and/or modified CDS sequence (opt2) from DENV-1__EU482527__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgccttcgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11425 - RNA, 9879 nt, synthetic construct
  misc_feature 1..9879: note = derived and/or modified CDS sequence (opt2) from DENV-1__EU482528__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagcactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcggcatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11426 - RNA, 9879 nt, synthetic construct
  misc_feature 1..9879: note = derived and/or modified CDS sequence (opt2) from DENV-1__EU482529__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccctccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11427 - RNA, 9879 nt, synthetic construct
  misc_feature 1..9879: note = derived and/or modified CDS sequence (opt2) from DENV-1__EU482531__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccaacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11428 - RNA, 9879 nt, synthetic construct
  misc_feature 1..9879: note = derived and/or modified CDS sequence (opt2) from DENV-1__EU482532__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgctccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11429 - RNA, 9879 nt, synthetic construct
  misc_feature 1..9879: note = derived and/or modified CDS sequence (opt2) from DENV-1__EU482533__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcatcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11430 - RNA, 9879 nt, synthetic construct
  misc_feature 1..9879: note = derived and/or modified CDS sequence (opt2) from DENV-1__EU482534__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11431 - RNA, 9879 nt, synthetic construct
  misc_feature 1..9879: note = derived and/or modified CDS sequence (opt2) from DENV-1__EU482535__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagccccgcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatcgacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11432 - RNA, 9879 nt, synthetic construct
  misc_feature 1..9879: note = derived and/or modified CDS sequence (opt2) from DENV-1__EU482536__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacatgctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11433 - RNA, 9879 nt, synthetic construct
  misc_feature 1..9879: note = derived and/or modified CDS sequence (opt2) from DENV-1__EU482537__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11434 - RNA, 9879 nt, synthetic construct
  misc_feature 1..9879: note = derived and/or modified CDS sequence (opt2) from DENV-1__EU482538__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgaccgcgagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacaccctcgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgaccgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11435 - RNA, 9879 nt, synthetic construct
  misc_feature 1..9879: note = derived and/or modified CDS sequence (opt2) from DENV-1__EU482539__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcaccctccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11436 - RNA, 9879 nt, synthetic construct
  misc_feature 1..9879: note = derived and/or modified CDS sequence (opt2) from DENV-1__KP188539__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaaggacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaccaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11437 - RNA, 9879 nt, synthetic construct
  misc_feature 1..9879: note = derived and/or modified CDS sequence (opt2) from DENV-1__KP188540__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatgctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgccaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11438 - RNA, 9879 nt, synthetic construct
  misc_feature 1..9879: note = derived and/or modified CDS sequence (opt2) from DENV-1__KP188541__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcttcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccgtcgaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11439 - RNA, 9879 nt, synthetic construct
  misc_feature 1..9879: note = derived and/or modified CDS sequence (opt2) from DENV-1__KP188543__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcgtcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11440 - RNA, 9879 nt, synthetic construct
  misc_feature 1..9879: note = derived and/or modified CDS sequence (opt2) from DENV-1__KP188544__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctgccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgcaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcaccacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11441 - RNA, 9879 nt, synthetic construct
  misc_feature 1..9879: note = derived and/or modified CDS sequence (opt2) from DENV-1__KP188547__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatcaagccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgccctcgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctcccctcctccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggcaccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11442 - RNA, 9879 nt, synthetic construct
  misc_feature 1..9879: note = derived and/or modified CDS sequence (opt2) from DENV-1__KP723473__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagtgcgactcccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcatccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggcaccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11443 - RNA, 9879 nt, synthetic construct
  misc_feature 1..9879: note = derived and/or modified CDS sequence (opt2) from DENV-1__KT187564__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtcttccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccgcctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11444 - RNA, 9879 nt, synthetic construct
  misc_feature 1..9879: note = derived and/or modified CDS sequence (opt2) from DENV-1__KT187560__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11445 - RNA, 9879 nt, synthetic construct
  misc_feature 1..9879: note = derived and/or modified CDS sequence (opt2) from DENV-1__KT187561__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcctcatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11446 - RNA, 9879 nt, synthetic construct
  misc_feature 1..9879: note = derived and/or modified CDS sequence (opt2) from DENV-1__KT187562__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11447 - RNA, 9879 nt, synthetic construct
  misc_feature 1..9879: note = derived and/or modified CDS sequence (opt2) from DENV-1__JQ045628__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagaccctcgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11448 - RNA, 9879 nt, synthetic construct
  misc_feature 1..9879: note = derived and/or modified CDS sequence (opt2) from DENV-1__JQ045629__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11449 - RNA, 9879 nt, synthetic construct
  misc_feature 1..9879: note = derived and/or modified CDS sequence (opt2) from DENV-1__JQ045630__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11450 - RNA, 9879 nt, synthetic construct
  misc_feature 1..9879: note = derived and/or modified CDS sequence (opt2) from DENV-1__JQ045632__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctcaagaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatcctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11451 - RNA, 9879 nt, synthetic construct
  misc_feature 1..9879: note = derived and/or modified CDS sequence (opt2) from DENV-1__JQ045633__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcgccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccagaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggtctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagtacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11452 - RNA, 9879 nt, synthetic construct
  misc_feature 1..9879: note = derived and/or modified CDS sequence (opt2) from DENV-1__JQ045634__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcgccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccagaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggtctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagtacgccgtctcccgcggcaccgccaagctccgctggttcgtcgagcgcaacctcgtcaagcccgagggcaaggtcatcgacctcggctgcggccgcggcggctgggcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11453 - RNA, 9879 nt, synthetic construct
  misc_feature 1..9879: note = derived and/or modified CDS sequence (opt2) from DENV-1__JQ045636__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccgacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgaccccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11454 - RNA, 9879 nt, synthetic construct
  misc_feature 1..9879: note = derived and/or modified CDS sequence (opt2) from DENV-1__JQ045635__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccgacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgaccccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctgggcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11455 - RNA, 9879 nt, synthetic construct
  misc_feature 1..9879: note = derived and/or modified CDS sequence (opt2) from DENV-1__JQ045637__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccctctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccgccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11456 - RNA, 9879 nt, synthetic construct
  misc_feature 1..9879: note = derived and/or modified CDS sequence (opt2) from DENV-1__JQ045638__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccctctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccgccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctgggcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11457 - RNA, 9879 nt, synthetic construct
  misc_feature 1..9879: note = derived and/or modified CDS sequence (opt2) from DENV-1__JQ045639__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggccgctgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11458 - RNA, 9879 nt, synthetic construct
  misc_feature 1..9879: note = derived and/or modified CDS sequence (opt2) from DENV-1__JQ045641__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcgcccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacaccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11459 - RNA, 9879 nt, synthetic construct
  misc_feature 1..9879: note = derived and/or modified CDS sequence (opt2) from DENV-1__JQ045642__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtgcgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11460 - RNA, 9879 nt, synthetic construct
  misc_feature 1..9879: note = derived and/or modified CDS sequence (opt2) from DENV-1__JQ045644__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccgccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11461 - RNA, 9879 nt, synthetic construct
  misc_feature 1..9879: note = derived and/or modified CDS sequence (opt2) from DENV-1__JQ045648__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcgcccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacaccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccaccacctgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11462 - RNA, 9879 nt, synthetic construct
  misc_feature 1..9879: note = derived and/or modified CDS sequence (opt2) from DENV-1__JQ045649__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtccgcgagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggcctccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctcaagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctccactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11463 - RNA, 9879 nt, synthetic construct
  misc_feature 1..9879: note = derived and/or modified CDS sequence (opt2) from DENV-1__JQ045650__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtccgcgagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggcctccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctgggcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctcaagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctccactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11464 - RNA, 9879 nt, synthetic construct
  misc_feature 1..9879: note = derived and/or modified CDS sequence (opt2) from DENV-1__JQ045651__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagtacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11465 - RNA, 9879 nt, synthetic construct
  misc_feature 1..9879: note = derived and/or modified CDS sequence (opt2) from DENV-1__JQ045652__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagtacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11466 - RNA, 9879 nt, synthetic construct
  misc_feature 1..9879: note = derived and/or modified CDS sequence (opt2) from DENV-1__JQ045653__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccaagaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactgcgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggaggacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11467 - RNA, 9879 nt, synthetic construct
  misc_feature 1..9879: note = derived and/or modified CDS sequence (opt2) from DENV-1__JQ045657__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11468 - RNA, 9879 nt, synthetic construct
  misc_feature 1..9879: note = derived and/or modified CDS sequence (opt2) from DENV-1__JQ045659__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgccgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccatggagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagaaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagcgcccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11469 - RNA, 9879 nt, synthetic construct
  misc_feature 1..9879: note = derived and/or modified CDS sequence (opt2) from DENV-1__JQ045661__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatgatcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagtacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11470 - RNA, 9879 nt, synthetic construct
  misc_feature 1..9879: note = derived and/or modified CDS sequence (opt2) from DENV-1__JQ045663__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggcccctccacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaactccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcctcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11471 - RNA, 9879 nt, synthetic construct
  misc_feature 1..9879: note = derived and/or modified CDS sequence (opt2) from DENV-1__JQ045665__SS-prME
  source 1..9879: mol_type = other RNA
tccgtcaccatgctcctcatgctcatgcccaccgccctcgccttccacctcaccgcccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcaacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgcctctcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccaccacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagtccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccaccacctgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11472 - RNA, 9879 nt, synthetic construct
  misc_feature 1..9879: note = derived and/or modified CDS sequence (opt2) from DENV-1__JQ045666__SS-prME
  source 1..9879: mol_type = other RNA
tccgtcaccatgctcctcatgctcatgcccaccgccctcgccttccacctcaccgcccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcaacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgcctctcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccaccacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagtccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11473 - RNA, 9879 nt, synthetic construct
  misc_feature 1..9879: note = derived and/or modified CDS sequence (opt2) from DENV-1__JQ045667__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccaactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatggcctgctacgtcatctccggctcctccgccgacctctccctcgagaaggccgccgaggtctcctgggaggaggaggccgagcactccggcgcctcccacaacatcctcgtcgaggtccagggcgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccatccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11474 - RNA, 9879 nt, synthetic construct
  misc_feature 1..9879: note = derived and/or modified CDS sequence (opt2) from DENV-1__KU094071__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccaaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcggcacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaagcgcaagtcctggctcgtccacaagcagtggttcctcgacctccccctcccctggacctccggcgcctccaccccccaggagacctggaaccgcgaggacctcctcgtcaccttcaagaccgcccacgccaagaagcaggaggtcgtcgtcctcggctcccaggagggcgccatgcacaccgccctcaccggcgccaccgagatccagacctccggcaccaccaagatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgctcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccgcctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccgcgccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcacccagggccgcaagatgatcggcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgacccccgcctcatgtccgccgccatcaaggactccaaggccgtccacgccgacatgggctactggatcgagtccgagaagaacgagacctggcgcctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctactccacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggacaaggaggagaacctcgtcaagtccctcgtctccgccggctccggcgaggtcgactccttctccctcggcctcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatcgccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccgccctcctctccctcaccttcatcaagaccaccttctccctccactacgcctggaagaccatggccatggtcctctccaccgtctccctcttccccctctgcctctccaccacctcccgcaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatctccatccccgccaccctcttcgtctggtacttccgccagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgtcatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgctccaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcggcaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgcaagtggtgcttcgacggcgagcgcaacaaccaggtcctcgaggagaacatggacgtcgagatctggaccaaggagggcgagcgcaagaagctccgcccccgctggctcgacgcccgcacctactccgacccccaggccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctgggtcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaacccccccaccctcatcgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctctccatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttccccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccatcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaaggacgagtccgacctcgagggcgccctctggtga

SEQ ID NO: 11475 - RNA, 9879 nt, synthetic construct
  misc_feature 1..9879: note = derived and/or modified CDS sequence (opt2) from DENV-1__HQ624983__SS-prME
  source 1..9879: mol_type = other RNA
tccgtcaccatgctcctcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatctccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccacctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgacatcatggagcccgagcacgccctcctcgccaactccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccgccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11476 - RNA, 9879 nt, synthetic construct
  misc_feature 1..9879: note = derived and/or modified CDS sequence (opt2) from DENV-1__FJ384655__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcgcctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccacctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcgccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagggcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtctcccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcggctaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11477 - RNA, 9879 nt, synthetic construct
  misc_feature 1..9879: note = derived and/or modified CDS sequence (opt2) from DENV-1__KC759167__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccgtcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggcccccgaggtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccaagccccccttcggcgagtcctgcatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcacccccccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcgccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcgcaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgagggcgtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagtacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagacctacgtcgagctcatgcgccgcggcgacctccccgtctggctctcctacaaggtcgcctccgagggcttccagtactccgaccgccgctggtacttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagctcgagttcaactcctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctcctcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgtcctcgactggctcgagaagtacggcatcgagcgcctcaagcgcatggccatctccggcgacgactgcgtcgtcaagcccatcgacaaccgcttcgccaccgccctcaccgccctcaacgacatgggcaaggtccgcaaggacatcccccagtgggagccctccaagggctggaacgactggcagcaggtccccctctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11478 - RNA, 9879 nt, synthetic construct
  misc_feature 1..9879: note = derived and/or modified CDS sequence (opt2) from DENV-1__JQ048541__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaagctccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggggcctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11479 - RNA, 9879 nt, synthetic construct
  misc_feature 1..9879: note = derived and/or modified CDS sequence (opt2) from DENV-1__JN697056__SS-prME
  source 1..9879: mol_type = other RNA
tccgtcaccatgctcctcatgctcctccccaccgccctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacatcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggccccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatgatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagtccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccaagaagatgctcatgaccggcaccctcgccgtcttcctcctcctcaccatgggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtcaagaccaccttctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagcgcaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatcctcgacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcgtcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgcccagctcatccgccagatggagtccgagggcatcttcctcccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11480 - RNA, 9879 nt, synthetic construct
  misc_feature 1..9879: note = derived and/or modified CDS sequence (opt2) from DENV-1__JN697057__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatctgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaaggtctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggtcaccctcctctccctcaccttcatcaagaccgccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagcgcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgccgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcgtcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccaagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11481 - RNA, 9879 nt, synthetic construct
  misc_feature 1..9879: note = derived and/or modified CDS sequence (opt2) from DENV-1__HQ624984__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagtccgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccctcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcaccgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11482 - RNA, 9879 nt, synthetic construct
  misc_feature 1..9879: note = derived and/or modified CDS sequence (opt2) from DENV-1__HQ891314__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaccgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11483 - RNA, 9879 nt, synthetic construct
  misc_feature 1..9879: note = derived and/or modified CDS sequence (opt2) from DENV-1__HQ891315__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatcgtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11484 - RNA, 9879 nt, synthetic construct
  misc_feature 1..9879: note = derived and/or modified CDS sequence (opt2) from DENV-1__HQ891316__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11485 - RNA, 9879 nt, synthetic construct
  misc_feature 1..9879: note = derived and/or modified CDS sequence (opt2) from DENV-1__JN054256__SS-prME
  source 1..9879: mol_type = other RNA
tccgtcaccatgctcctcatgctcatgcccaccgccctcgccttccacctcaccacccgcgagggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaccgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcatcgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11486 - RNA, 9879 nt, synthetic construct
  misc_feature 1..9879: note = derived and/or modified CDS sequence (opt2) from DENV-1__JN054255__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagatgtccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagaactggggcaaggccaagatcatcggcgccgacgtccagaactccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagaaggccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccggcatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagatgcgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgagaaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcatggtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgcccctccaagaacggcaccgtcatggacgtcatctcccgccgcgaccagcgcggctccggccaggtcggcacctacggcctcaacaccttcaccaacatggaggcccagctcatccgccagatggagtccgaggagatcttctcccccaacgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11487 - RNA, 9879 nt, synthetic construct
  misc_feature 1..9879: note = derived and/or modified CDS sequence (opt2) from DENV-1__KP406801__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacaccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcgccggcgccaccgagatccagatgtccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccatccaggacgagaagggcgtcacccagaacggccgcctcatcaccgccaaccccatcgccaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtccgccccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagaagttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11488 - RNA, 9879 nt, synthetic construct
  misc_feature 1..9879: note = derived and/or modified CDS sequence (opt2) from DENV-1__KP406802__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcatcaacatgtgcaccctcatcgccatggacctcggcgagctctgcgaggacaccctcacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagatctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccacccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11489 - RNA, 9879 nt, synthetic construct
  misc_feature 1..9879: note = derived and/or modified CDS sequence (opt2) from DENV-1__KP406803__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaaggtcatcggcgccgacgtccagaacatcaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcacccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatccccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctccgcatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11490 - RNA, 9879 nt, synthetic construct
  misc_feature 1..9879: note = derived and/or modified CDS sequence (opt2) from DENV-1__KJ438293__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagatctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccggcttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcgtcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatcctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactggatctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11491 - RNA, 9879 nt, synthetic construct
  misc_feature 1..9879: note = derived and/or modified CDS sequence (opt2) from DENV-1__KJ438296__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtcttccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccgcctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11492 - RNA, 9879 nt, synthetic construct
  misc_feature 1..9879: note = derived and/or modified CDS sequence (opt2) from DENV-1__KC692495__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga
